United States Patent 11,931,406 (FLAVIVIRUS VACCINE) - sequence listing, part 29

SEQ ID NO: 11915 - RNA, 9876 nt, Artificial Sequence
  derived and/or modified CDS sequence (opt2) from DENV-2__EU482763__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacaccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11916 - RNA, 9876 nt, Artificial Sequence
  derived and/or modified CDS sequence (opt2) from DENV-2__EU482444__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccauccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgucauguacgccgacgacaccgccggcugggacacccgcaucacccucgaggaccucaagaacgaggagcucgucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11917 - RNA, 9876 nt, Artificial Sequence
  derived and/or modified CDS sequence (opt2) from DENV-2__EU482684__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccaccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11918 - RNA, 9876 nt, Artificial Sequence
  derived and/or modified CDS sequence (opt2) from DENV-2__EU482685__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggcaacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgccaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11919 - RNA, 9876 nt, Artificial Sequence
  derived and/or modified CDS sequence (opt2) from DENV-2__EU482687__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccguccucgccuacaccaucggcaccacccacuuccagcgcgcccucaucuucguccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaugaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11920 - RNA, 9876 nt, Artificial Sequence
  derived and/or modified CDS sequence (opt2) from DENV-2__EU482688__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucucccucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcaucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcuccaugaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11921 - RNA, 9876 nt, Artificial Sequence
  derived and/or modified CDS sequence (opt2) from DENV-2__EU482691__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaucaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacaccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11922 - RNA, 9876 nt, Artificial Sequence
  derived and/or modified CDS sequence (opt2) from DENV-2__EU482693__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccacccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccgccgaggagaacgucguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11923 - RNA, 9876 nt, Artificial Sequence
  derived and/or modified CDS sequence (opt2) from DENV-2__EU596483__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggauggaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacaccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggagaccggcguccucugguga

SEQ ID NO: 11924 - RNA, 9876 nt, Artificial Sequence
  derived and/or modified CDS sequence (opt2) from DENV-2__EU482597__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucuccgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagauccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11925 - RNA, 9876 nt, Artificial Sequence
  derived and/or modified CDS sequence (opt2) from DENV-2__EU482598__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11926 - RNA, 9876 nt, Artificial Sequence
  derived and/or modified CDS sequence (opt2) from DENV-2__EU482603__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgccgagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcgacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaagaccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgucguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11927 - RNA, 9876 nt, Artificial Sequence
  derived and/or modified CDS sequence (opt2) from DENV-2__EU482599__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggucaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11928 - RNA, 9876 nt, Artificial Sequence
  derived and/or modified CDS sequence (opt2) from DENV-2__FJ898436__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgccuggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11929 - RNA, 9876 nt, Artificial Sequence
  derived and/or modified CDS sequence (opt2) from DENV-2__EU482634__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacaccaaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgucguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11930 - RNA, 9876 nt, Artificial Sequence
  derived and/or modified CDS sequence (opt2) from DENV-2__EU482635__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucuccgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11931 - RNA, 9876 nt, Artificial Sequence
  derived and/or modified CDS sequence (opt2) from DENV-2__GQ199874__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11932 - RNA, 9876 nt, Artificial Sequence
  derived and/or modified CDS sequence (opt2) from DENV-2__EU482639__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccacccucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgagacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagauccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11933 - RNA, 9876 nt, Artificial Sequence
  derived and/or modified CDS sequence (opt2) from DENV-2__EU482766__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccucccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11934 - RNA, 9876 nt, Artificial Sequence
  derived and/or modified CDS sequence (opt2) from DENV-2__EU482695__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11935 - RNA, 9876 nt, Artificial Sequence
  derived and/or modified CDS sequence (opt2) from DENV-2__EU482769__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcuccaugaucggccucaccucccgcgccaccugggccaagaacauccagaccgccaucaaccagguccgcucccucaucggcaacgaggaguacaucgacuacaugcccuccaugaagcgcuuccgccgcgaggaggaggaggccggcguccucugguga

SEQ ID NO: 11936 - RNA, 9876 nt, Artificial Sequence
  derived and/or modified CDS sequence (opt2) from DENV-2__EU482696__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgccuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccacccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaccuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaucgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccgccgaggagaucgucguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11937 - RNA, 9876 nt, Artificial Sequence
  derived and/or modified CDS sequence (opt2) from DENV-2__KC294207__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacugcaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccggccaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucgucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgucgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11938 - RNA, 9876 nt, Artificial Sequence
  derived and/or modified CDS sequence (opt2) from DENV-2__KC294208__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcgaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucgucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgucgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11939 - RNA, 9876 nt, Artificial Sequence
  derived and/or modified CDS sequence (opt2) from DENV-2__KC294209__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucgucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgucgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11940 - RNA, 9876 nt, Artificial Sequence
  derived and/or modified CDS sequence (opt2) from DENV-2__KC294214__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggcgcaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucgucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccaccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgucgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11941 - RNA, 9876 nt, Artificial Sequence
  derived and/or modified CDS sequence (opt2) from DENV-2__KC294205__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccaccagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaccaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucgucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgucgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11942 - RNA, 9876 nt, Artificial Sequence
  derived and/or modified CDS sequence (opt2) from DENV-2__KC294210__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaugauggaguccuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucgucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucguccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgucgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11943 - RNA, 9876 nt, Artificial Sequence
  derived and/or modified CDS sequence (opt2) from DENV-2__KC294215__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucgucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccaaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgucgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11944 - RNA, 9876 nt, Artificial Sequence
  derived and/or modified CDS sequence (opt2) from DENV-2__KC294216__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgaccucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcgaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuuccucacccucaucaccggcaacauguccuuccgcgaccucggccgcgucauggucauggucggcgucgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccacccccgagaccauccucgagcucaccgacgcccucgcccucggcaugaugguccucaagaucguccgcaacauggagaaguaccagcucgccgucaccaucaugaccaucuccugcguccccaacgccaugauccucaucaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggagguccgcaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagcgcgaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgccaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccgucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11945 - RNA, 9876 nt, Artificial Sequence
  derived and/or modified CDS sequence (opt2) from DENV-2__KC294218__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucauccucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucgucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgucgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11946 - RNA, 9876 nt, Artificial Sequence
  derived and/or modified CDS sequence (opt2) from DENV-2__KC294220__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaugugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucgucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgucgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11947 - RNA, 9876 nt, Artificial Sequence
  derived and/or modified CDS sequence (opt2) from DENV-2__KC294221__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcgcggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucgucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgucgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11948 - RNA, 9876 nt, Artificial Sequence
  derived and/or modified CDS sequence (opt2) from DENV-2__KC294223__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucgucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgucgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11949 - RNA, 9876 nt, Artificial Sequence
  derived and/or modified CDS sequence (opt2) from DENV-2__FJ906959__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugccccuuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgacucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacaugaagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagaugaucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaucaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccagccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaagauggagaaguaccagcucgccgucaccaucauggccauccucugcguccccaacgccgucauccuccagaacgccuggaaggucuccugcaccauccucgccgucgucuccgucuccccccucuuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgcaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccugguccuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11950 - RNA, 9876 nt, Artificial Sequence
  derived and/or modified CDS sequence (opt2) from DENV-2__KF360005__SS-prME
accgccggcgucaucaucaugcgcauccccaccgccauggccuuccaccucaccacccgcaacggcgagccccacaugaucgucuccaagcaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucggccgcggcuggggcgacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacauccagggcuccaacuggauccagaaggagacccucgucaccuucaagaacccccacgccaagaagcaggacgucgucguccucggcucccaggagggcgcccuccacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcauccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggcgcaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucuccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccacccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgaggucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucuccgccguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggccgcaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcgccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgccgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcucccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacucccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgagguccgcggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccgucgucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucgcccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagaucggcgaguucggcaaggccaagggcucccgcgccgucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcuccuccggccaggucggcaccuacggccucaacaccuucaccaacaugggcgcccagcucauccgccagauggagggcgagggcgucuucaagggcauccagcaccucaccgccaccgaggaggucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcggccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcggcgaccaguggugcggcucccucaucggccucaccucccgcgccaccugggcccgcaacauccagaccgccaucaaccgcguccgcucccucaucggcuccgagggcuacaccgacuacaugcccuccaugaagcgcuuccgccgcgaggaggacgaggccggcguccucugguga

SEQ ID NO: 11951 - RNA, 9876 nt, Artificial Sequence
  derived and/or modified CDS sequence (opt2) from DENV-2__KJ010185__SS-prME
accgccggcgucaucaucaugcucauccccaccgccauggccuuccaccucaccacccgcaacggcgagccccacaugaucgucuccaagcaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacgccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacauccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaacccccucuucaccggccaccucaagugccgccuccgcauggacaagcuccagcucaagggcauguccuacuccaugugcaccggcaaguucaaggucgucaaggagaucgccgagacccagcacggcaccaucgucguccgcauccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucuucaccgacaacguccacaccuggaccgagcaguacaaguuccagcccgagucccccuccaagcucgccuccgccauccagaaggcccacgaggagggcaucugcggcauccgcuccaucacccgccucgacaaccucauguggaagcagaucacccccgagcucaaccacauccucuccgagaacgaggucaagcucuccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgcccagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccacccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccucccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgcgucucccuccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccucaccggcgccgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgaccccgacgucgaccucggcuccggcacccgcaacaucggcaucgaguccgagacccccaaccucgacaucaucggcaagcgcaucgagaagaucaagcaggagcacgagaccucccgccacuacgaccaggaccaccccuacaagaccugggccuaccacggcuccuacgagaccaagcagaccggcuccgccuccuccaccgucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucgcccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagaucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccguccaggucggcaccuacggccucggcaccuucaccaacaugggcgcccagcucauccgccagauggagggcgagggcgucuucaagggcauccagcaccucaccgccaccgaggaggucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccggccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggcccgcaacauccagaccgccaucaaccagguccgcucccucaucggcuccgaggaguacaccgacuacaugcccuccaugaagcgcuucggccgcgaggaggaggaggccggcguccucugguga

SEQ ID NO: 11952 - RNA, 9876 nt, Artificial Sequence
  derived and/or modified CDS sequence (opt2) from DENV-2__KJ010186__SS-prME
accgccggcgucaucaucaugcucauccccaccgccauggccuuccaccucaccacccgcaacggcgagccccacaugaucgucuccaagcaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacgccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggcccgccucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacauccagggcuccaacuggauccagaaggagacccucgucaccuucaagaagccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaccgcccucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucuccaucaugaccggcgacaucaagggcauccuccaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccacccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccgcuccuacccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacucccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucgcccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagaucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaagggcauccagcaccucaccgccaccgaggaggucgccguccaggacuggcucgcccgcgucggccgcgagcgccucucccgcauggccaucuccggcgacgacugcgucgucaagccccucgacgaccgcuucgccaacgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggcccgcaacauccagaccgccaucaaccagguccgcucccucaucggcuccgaggaguacaccgacuacaugcccuccaugaagcgcuuccgccgcgaggaggaggaggccggcguccucugguga

SEQ ID NO: 11953 - RNA, 9876 nt, Artificial Sequence
  derived and/or modified CDS sequence (opt2) from DENV-2__KF955364__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacggcgucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacguccucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaaguacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11954 - RNA, 9876 nt, Artificial Sequence
  derived and/or modified CDS sequence (opt2) from DENV-2__KF955372__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggaguacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacgucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaccgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11955 - RNA, 9876 nt, Artificial Sequence
  derived and/or modified CDS sequence (opt2) from DENV-2__KF955373__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuucccccucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11956 - RNA, 9876 nt, Artificial Sequence
  derived and/or modified CDS sequence (opt2) from DENV-2__GQ868600__SS-prME
accgccggcaugaucaucaugcucauccccaccgucauggccuuccaccucaccacccgcaacggcgagccccacaugaucgucucccgccaggagaagggcaagucccuccucuucaagaccaaggacggcaccaacaugugcacccucauggccauggaccucggcgagcucugcgaggacaccaucaccuacaagugccccuuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccaucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgacucccgcugccccacccagggcgagcccacccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccgucgucaucaccccccacuccggcgaggagcacgccgucggcaacgacaccggcaagcacggcaaggaggucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucgacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucaccuccgagcucaaccacauccucuccgagaacgaggucaagcucaccaucaugaccggcgacaucaagggcaucaugcaggucggcaagcgcucccuccgcccccagcccaccgagcuccgcuacuccuggaagaccuggggcaaggccaagaugcucuccaccgagcuccacaaccagaccuuccucaucgacggccccgagaccgccgagugccccaacaccaaccgcgccuggaacucccucgaggucgaggacuacggcuucggcgucuucaccaccaacaucuggcuccgccuccgcgagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagauggucauccccaagaacuucgccggccccgucucccagcacaacaaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucuccucccucgucaccgccggccacggccagaucgacaacuucucccucggcauccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccuccauccccgagaccauccucgagcucaccgacgcccucgcccucggcaugaugguccucaagaugguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggacgaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuuccgcaccaacaccggcaccaucggcgccgucucccucgacuucucccccggcaccuccggcucccccaucgucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaagaccggcaacgacaucgccgccugccuccgcaagaacggcaagcgcgucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaacccccgcaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcacccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucaucaucgccauccucaccgucgucgccgccaccauggccaacgagaugggcuuccucgagaagaccaagaaggaccucggccucggcaacaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccgucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucgucccccccgagaagugcgacacccuccucugcgacaucggcgaguccucccccaaccccaccgucgaggccggccgcacccuccgcguccucaaccucgucgagaacuggcucaacaacaacacccaguucugcgucaagguccucaaccccuacaugcccuccgucaucgagcgcauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucaccaucgaggaccucaagaacgaggagaugaucaccaaccacauggccggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccuccgaggagaucgccguccaggacuggcucguccgcgucggccgcgagcgccucucccgcauggccaucuccggcgacgacugcgucgucaagccccucgacgaccgcuucgcccgcgcccucaccgcccucaacgacaugggcaagguccgcaaggacauccagcagugggagcccucccgcggcuggaacgacuggacccagguccccuucugcucccaccacuuccacgagcucaucaugaaggacggccgcacccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccucccacgaguggaugaccaccgaggacaugcucaccgucuggaacaaggucuggauccucgagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11957 - RNA, 9876 nt, Artificial Sequence
  derived and/or modified CDS sequence (opt2) from DENV-2__KF955359__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaccauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccauccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgccucccucguccucgucggcaucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagaaggccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcaugcucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11958 - RNA, 9876 nt, Artificial Sequence
  derived and/or modified CDS sequence (opt2) from DENV-2__KF955360__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcgccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11959 - RNA, 9876 nt, Artificial Sequence
  derived and/or modified CDS sequence (opt2) from DENV-2__KF955363__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuuccucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcaggucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggucaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11960 - RNA, 9876 nt, Artificial Sequence
  derived and/or modified CDS sequence (opt2) from DENV-2__EU726767__SS-prME
uccgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcgccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacgucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucaugacccucaucaccggcaacauguccuucaaggaccucggccgcgucgucgucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucgcccuccucucccaguccaccauccccgagaccauccucgagcucaccgacgcccucgcccucggcaugaugguccucaagaugguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgucacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccgucuucaccgacgagaacaaguggaaguccgcccgcgaggccgucgaggacucccgcuucugggagcucgucgacaaggagcgcucccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11961 - RNA, 9876 nt, Artificial Sequence
  derived and/or modified CDS sequence (opt2) from DENV-2__EU687246__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgcccucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaacauccccgagaccauccucgagcucaccgacgcccucgcccucggcaugaugguccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgacaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucaucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcuccgaggaguacaccgacuacaugcccuccaugaagcgcuuccgccgcgaggaggaggaggccggcguccucugguga

SEQ ID NO: 11962 - RNA, 9876 nt, Artificial Sequence
  derived and/or modified CDS sequence (opt2) from DENV-2__FJ639828__SS-prME
uccgucggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcacccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgccaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccucuuccuccgcaagcucaccuccaaggagcucaugaugaccaccaucggcaucguccuccucucccaguccacccuccccgagaccauccucgagcucaccgacgcccucgcccucggcaugaugguccucaagaugguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagcgcggcauccucggcuacucccagaucggcgccggcgucuacaaggagggcaccuuccacaccauguggcacgucacccgcggcgccguccucacccacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgacaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucgucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgccccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacucccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11963 - RNA, 9876 nt, Artificial Sequence
  derived and/or modified CDS sequence (opt2) from DENV-2__FJ639829__SS-prME
uccgucggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcacccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccucuuccuccgcaagcucaccuccaaggagcucaugaugaccaccaucggcaucguccuccucucccaguccaccauccccgagaccauccucgagcucaccgacgcccucgcccucggcaugaugguccucaagaugguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagcgcggcauccucggcuacucccagaucggcgccggcgucuacaaggagggcaccuuccacaccauguggcacgucacccgcggcgccguccucacccacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgacaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucgucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgccccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacucccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggucgccaucaaccagguccgcucccucaucggcaacgaggaguacaccgacuacaugcccuccaugaagcgcuuccgccgcgaggaggaggaggccggcguccucugguga

SEQ ID NO: 11964 - RNA, 9876 nt, Artificial Sequence
  derived and/or modified CDS sequence (opt2) from DENV-2__FJ639831__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccaucgucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccgucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgucgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcguccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgacaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggccaugugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaagaccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaagcuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucaucuacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11965 - RNA, 9876 nt, Artificial Sequence
  derived and/or modified CDS sequence (opt2) from DENV-2__FJ639832__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11966 - RNA, 9876 nt, Artificial Sequence
  derived and/or modified CDS sequence (opt2) from DENV-2__FJ687434__SS-prME
uccgucggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcacccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggcccgccucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccucccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgacaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucgucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgccccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggccaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacucccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11967 - RNA, 9876 nt, Artificial Sequence
  derived and/or modified CDS sequence (opt2) from DENV-2__FJ687439__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgccaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacaucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11968 - RNA, 9876 nt, Artificial Sequence
  derived and/or modified CDS sequence (opt2) from DENV-2__FJ687440__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccuggaucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaccggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggagaucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11969 - RNA, 9876 nt, Artificial Sequence
  derived and/or modified CDS sequence (opt2) from DENV-2__FJ687441__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccuggaucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggagaucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11970 - RNA, 9876 nt, Artificial Sequence
  derived and/or modified CDS sequence (opt2) from DENV-2__FJ687445__SS-prME
uccgucggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcacccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccucuuccuccgcaagcucaccuccaaggagcucaugaugaccaccaucggcaucguccuccucucccaguccaccauccccgagaccauccucgagcucaccgacgcccucgcccucggcaugaugguccucaagaugguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagcgcggcauccucggcuacucccagaucggcgccggcgucuacaaggagggcaccuuccacaccauguggcacgucacccgcggcgccguccucacccacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgacaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucgucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgccccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccaucccccacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacucccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggucgccaucaaccagguccgcucccucaucggcaacgaggaguacaccgacuacaugcccuccaugaagcgcuuccgccgcgaggaggaggaggccggcguccucugguga

SEQ ID NO: 11971 - RNA, 9876 nt, Artificial Sequence
  derived and/or modified CDS sequence (opt2) from DENV-2__FJ687447__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccucccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuucaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11972 - RNA, 9876 nt, Artificial Sequence
  derived and/or modified CDS sequence (opt2) from DENV-2__FJ810411__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccucccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuucaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11973 - RNA, 9876 nt, Artificial Sequence
  derived and/or modified CDS sequence (opt2) from DENV-2__FJ744713__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccucccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagauccucaccauccucauccgcaccggccuccucgucaucuccggccucuuccccaucuccauccccaucaccgccgccgccugguaccucugggaggucaagaagcagcgcgccggcguccucugggacguccccucccccccccccaucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuucaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11974 - RNA, 9876 nt, Artificial Sequence
  derived and/or modified CDS sequence (opt2) from DENV-2__FJ744714__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagcgcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11975 - RNA, 9876 nt, Artificial Sequence
  derived and/or modified CDS sequence (opt2) from DENV-2__FJ744716__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagcgcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccgcaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11976 - RNA, 9876 nt, Artificial Sequence
  derived and/or modified CDS sequence (opt2) from DENV-2__FJ744718__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcucccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11977 - RNA, 9876 nt, Artificial Sequence
  derived and/or modified CDS sequence (opt2) from DENV-2__FJ744722__SS-prME
uccgucggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcacccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccaaccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccucuuccuccgcaagcucaccuccaaggagcucaugaugaccaccaucggcaucguccuccucucccaguccaccauccccgagaccauccucgagcucaccgacgcccucgcccucggcaugaugguccucaagaugguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagcgcggcauccucggcuacucccagaucggcgccggcgucuacaaggagggcaccuuccacaccauguggcacgucacccgcggcgccguccucacccacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgacaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucgucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgccccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacucccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggucgccaucaaccagguccgcucccucaucggcaacgaggaguacaccgacuacaugcccuccaugaagcgcuuccgccgcgaggaggaggaggccggcguccucugguga

SEQ ID NO: 11978 - RNA, 9876 nt, Artificial Sequence
  derived and/or modified CDS sequence (opt2) from DENV-2__FJ744723__SS-prME
uccgucggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcacccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccucuuccuccgcaagcucaccuccaaggagcucaugaugaccaccaucggcaucguccuccucucccaguccaccauccccgagaccauccucgagcucaccgacgcccucgcccucggcaugaugguccucaagaugguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagcgcggcauccucggcuacucccagaucggcgccggcgucuacaaggagggcaccuuccacaccauguggcacgucacccgcggcgccguccucacccacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgacaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucgucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgccccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacucccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaccgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggucgccaucaaccagguccgcucccucaucggcaacgaggaguacaccgacuacaugcccuccaugaagcgcuuccgccgcgaggaggaggaggccggcguccucugguga

SEQ ID NO: 11979 - RNA, 9876 nt, Artificial Sequence
  derived and/or modified CDS sequence (opt2) from DENV-2__FJ744724__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccaucgucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccgucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11980 - RNA, 9876 nt, Artificial Sequence
  derived and/or modified CDS sequence (opt2) from DENV-2__FJ906957__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgccuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11981 - RNA, 9876 nt, Artificial Sequence
  derived and/or modified CDS sequence (opt2) from DENV-2__FJ906958__SS-prME
uccgucggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagguccccuucgagaucauggaccucgagaagcgcuacguccucggccgccucaucaccgucaaccccgucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccgucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccagggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgacaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgccaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucgucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagcgccucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11982 - RNA, 9876 nt, Artificial Sequence
  derived and/or modified CDS sequence (opt2) from DENV-2__FJ898452__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11983 - RNA, 9876 nt, Artificial Sequence
  derived and/or modified CDS sequence (opt2) from DENV-2__GQ868591__SS-prME
uccgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaugggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucacccccuccaugaccaugcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucacccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucaccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgcuacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucgccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccaucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11984 - RNA, 9876 nt, Artificial Sequence
  derived and/or modified CDS sequence (opt2) from DENV-2__GQ868542__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcggcaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcaccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgacuccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11985 - RNA, 9876 nt, Artificial Sequence
  derived and/or modified CDS sequence (opt2) from DENV-2__GQ868544__SS-prME
uccgucggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagguccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccagggccagaucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgacaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucgucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccucuacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11986 - RNA, 9876 nt, Artificial Sequence
  derived and/or modified CDS sequence (opt2) from DENV-2__GQ868545__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccaucgucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccgucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccacccucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcgacauggagaaguaccagcucgccgucaccaucauggccacccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgacaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaagcuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11987 - RNA, 9876 nt, Artificial Sequence
  derived and/or modified CDS sequence (opt2) from DENV-2__GQ868543__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcauguucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgucaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11988 - RNA, 9876 nt, Artificial Sequence
  derived and/or modified CDS sequence (opt2) from DENV-2__EU482544__SS-prME
accgccggcgucaucaucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11989 - RNA, 9876 nt, Artificial Sequence
  derived and/or modified CDS sequence (opt2) from DENV-2__EU482545__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucaugaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccgucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugauggcccucaagaucgucaagaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccauccgcaacgaggaggaggagcagacccucaccauccucauccgcaccggccuccucgucaucuccggcgucuuccccgucuccauccccgucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucgucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11990 - RNA, 9876 nt, Artificial Sequence
  derived and/or modified CDS sequence (opt2) from DENV-2__EU482546__SS-prME
accgccggcgucaucgucaugcucauccccaccgucauggccuuccaccucaccacccgcaacggcgagccccacaugaucgucggccgccaggagaagggcaagucccuccucuucaagaccgaggacggcaucaacaugugcacccucauggccaucgaccucggcgagcucugcgaggacaccaucaccuacaagugcccccuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgccuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaaccaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcuuccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcgucugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucucccagguccgcucccucaucggcaacgaggaguacaccgacuacaugcccuccaugaagcgcuuccgccgcgaggaggaggaggccggcguccucugguga

SEQ ID NO: 11991 - RNA, 9876 nt, Artificial Sequence
  derived and/or modified CDS sequence (opt2) from DENV-2__EU482550__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaucacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcucccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccucgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11992 - RNA, 9876 nt, Artificial Sequence
  derived and/or modified CDS sequence (opt2) from DENV-2__EU482551__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaccauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagaaggccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcaugcucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11993 - RNA, 9876 nt, Artificial Sequence
  derived and/or modified CDS sequence (opt2) from DENV-2__EU482552__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaccggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggcuacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11994 - RNA, 9876 nt, Artificial Sequence
  derived and/or modified CDS sequence (opt2) from DENV-2__EU482554__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaccgucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaucacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcucccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccucgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11995 - RNA, 9876 nt, Artificial Sequence
  derived and/or modified CDS sequence (opt2) from DENV-2__EU482556__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgucucccacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccguccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccacccucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucguccgcgucggccgcgagcgccucucccgcauggccgucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11996 - RNA, 9876 nt, Artificial Sequence
  derived and/or modified CDS sequence (opt2) from DENV-2__EU529693__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaccauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcaugcucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11997 - RNA, 9876 nt, Artificial Sequence
  derived and/or modified CDS sequence (opt2) from DENV-2__EU482557__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11998 - RNA, 9876 nt, Artificial Sequence
  derived and/or modified CDS sequence (opt2) from DENV-2__EU482560__SS-prME
accgccggcgucaucgucaugcucauccccaccgucauggccuuccaccucaccacccgcaacggcgagccccacaugaucgucggccgccaggagaagggcaagucccuccucuucaagaccgaggacggcaucaacaugugcacccucauggccaucgaccucggcgagcucugcgaggacaccaucaccuacaagugcccccuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgccuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaaccaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucucccucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcuuccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgagaacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcgucugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucucccagguccgcucccucaucggcaacgaggaguacaccgacuacaugcccuccaugaagcgcuuccgccgcgaggaggaggaggccggcguccucugguga

SEQ ID NO: 11999 - RNA, 9876 nt, Artificial Sequence
  derived and/or modified CDS sequence (opt2) from DENV-2__EU482561__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccaugcuccucgucgucgucuccuucgucacccucaucaccggcaacauguccuuccgcgaccucggccgcgucauggucauggucggcgccaccaugaccgacgacaucggcaugggcaucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12000 - RNA, 9876 nt, Artificial Sequence
  derived and/or modified CDS sequence (opt2) from DENV-2__EU569703__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12001 - RNA, 9876 nt, Artificial Sequence
  derived and/or modified CDS sequence (opt2) from DENV-2__EU529694__SS-prME
accgccggcgucuucaucaugcucauccccaccgccauggccuuccaccucaccacccgcaacggcgagccccacaugaucgucggccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccaugcuccucgucgccgucuccuucgucacccucaucaccggcaacauguccuuccgcgaccucggccgcgucauggucauggucggcgccaccaugaccgacgacaucggcaugggcaucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12002 - RNA, 9876 nt, Artificial Sequence
  derived and/or modified CDS sequence (opt2) from DENV-2__EU529695__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaucacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12003 - RNA, 9876 nt, Artificial Sequence
  derived and/or modified CDS sequence (opt2) from DENV-2__EU482562__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucauccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuucauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12004 - RNA, 9876 nt, Artificial Sequence
  derived and/or modified CDS sequence (opt2) from DENV-2__EU482565__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacauccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgaguccccccccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacgucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12005 - RNA, 9876 nt, Artificial Sequence
  derived and/or modified CDS sequence (opt2) from DENV-2__EU529700__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaaccucgagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12006 - RNA, 9876 nt, Artificial Sequence
  derived and/or modified CDS sequence (opt2) from DENV-2__EU529701__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuuccucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccgucggcaaggcccuccaccaggucuucggcgccaucuacggcgccgccuucuccggcgucuccuggaccaugaagaucuucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12007 - RNA, 9876 nt, Artificial Sequence
  derived and/or modified CDS sequence (opt2) from DENV-2__EU569704__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuuccucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcauccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12008 - RNA, 9876 nt, Artificial Sequence
  derived and/or modified CDS sequence (opt2) from DENV-2__EU482568__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuuccucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcauccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcgucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagaugugggcccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12009 - RNA, 9876 nt, Artificial Sequence
  derived and/or modified CDS sequence (opt2) from DENV-2__EU482569__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaagaacgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucauccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12010 - RNA, 9876 nt, Artificial Sequence
  derived and/or modified CDS sequence (opt2) from DENV-2__EU482570__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuuccucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcaggucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucggcugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccucaaggacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggucaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12011 - RNA, 9876 nt, Artificial Sequence
  derived and/or modified CDS sequence (opt2) from DENV-2__EU482571__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuuccucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgccuggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12012 - RNA, 9876 nt, Artificial Sequence
  derived and/or modified CDS sequence (opt2) from DENV-2__EU482572__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuuccucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcaggucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccggcgacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccaggucaugaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgaggccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggucaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12013 - RNA, 9876 nt, Artificial Sequence
  derived and/or modified CDS sequence (opt2) from DENV-2__EU482573__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuuccucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12014 - RNA, 9876 nt, Artificial Sequence
  derived and/or modified CDS sequence (opt2) from DENV-2__EU482574__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuuccucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccacauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12015 - RNA, 9876 nt, Artificial Sequence
  derived and/or modified CDS sequence (opt2) from DENV-2__EU482575__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcgccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuuccucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12016 - RNA, 9876 nt, Artificial Sequence
  derived and/or modified CDS sequence (opt2) from DENV-2__EU482578__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12017 - RNA, 9876 nt, Artificial Sequence
  derived and/or modified CDS sequence (opt2) from DENV-2__EU482580__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuuccucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagaucuucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12018 - RNA, 9876 nt, Artificial Sequence
  derived and/or modified CDS sequence (opt2) from DENV-2__EU482581__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12019 - RNA, 9876 nt, Artificial Sequence
  derived and/or modified CDS sequence (opt2) from DENV-2__EU482582__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccaaccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgucuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaccaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccaccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12020 - RNA, 9876 nt, Artificial Sequence
  derived and/or modified CDS sequence (opt2) from DENV-2__EU482583__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacgccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12021 - RNA, 9876 nt, Artificial Sequence
  derived and/or modified CDS sequence (opt2) from DENV-2__EU482585__SS-prME
accgccggcgucaucaucaugcucauccccaccgccaucgccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcggcaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagauggucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacuccaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12022 - RNA, 9876 nt, Artificial Sequence
  derived and/or modified CDS sequence (opt2) from DENV-2__EU482587__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggucgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagucccgcgagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccgcaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagaucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12023 - RNA, 9876 nt, Artificial Sequence
  derived and/or modified CDS sequence (opt2) from DENV-2__EU482588__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagguccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12024 - RNA, 9876 nt, Artificial Sequence
  derived and/or modified CDS sequence (opt2) from DENV-2__EU569705__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccaugcuccucgucgccgucuccuucgucacccucaucaccggcaacauguccuuccgcgaccucggccgcgucauggucauggucggcgccaccaugaccgacgacaucggcaugggcaucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucgucaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12025 - RNA, 9876 nt, Artificial Sequence
  derived and/or modified CDS sequence (opt2) from DENV-2__EU482589__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaugggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaaccucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucgucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12026 - RNA, 9876 nt, Artificial Sequence
  derived and/or modified CDS sequence (opt2) from DENV-2__EU569706__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaaccucgagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12027 - RNA, 9876 nt, Artificial Sequence
  derived and/or modified CDS sequence (opt2) from DENV-2__EU569707__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcgucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccgcauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccaugcuccucgucgccgucuccuucgucacccucaucaccggcaacauguccuuccgcgaccucggccgcgucauggucauggucggcgccaccaugaccgacgacaucggcaugggcaucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12028 - RNA, 9876 nt, Artificial Sequence
  derived and/or modified CDS sequence (opt2) from DENV-2__EU660399__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccaugcuccucgucgccgucuccuucgucacccucaucaccggcaacauguccuuccgcgaccucggccgcgucauggucauggucggcgccaccaugaccgacgacaucggcaugggcaucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgccagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagaaguaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12029 - RNA, 9876 nt, Artificial Sequence
  derived and/or modified CDS sequence (opt2) from DENV-2__EU569708__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaucaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccucaacgccuggaaggucuccugcaccauccucgccgccgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccgucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagcgcaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccgucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgccgcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12030 - RNA, 9876 nt, Artificial Sequence
  derived and/or modified CDS sequence (opt2) from DENV-2__EU569709__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaucacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12031 - RNA, 9876 nt, Artificial Sequence
  derived and/or modified CDS sequence (opt2) from DENV-2__EU596485__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgacucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaucacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucgcccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12032 - RNA, 9876 nt, Artificial Sequence
  derived and/or modified CDS sequence (opt2) from DENV-2__EU569710__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaccuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccauccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaucacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12033 - RNA, 9876 nt, Artificial Sequence
  derived and/or modified CDS sequence (opt2) from DENV-2__EU596486__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaucacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcucccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaucgacuacaugcccuccaugaagcgcuuccgcaaggaggaggaggaggccggcguccucugguga

SEQ ID NO: 12034 - RNA, 9876 nt, Artificial Sequence
  derived and/or modified CDS sequence (opt2) from DENV-2__EU687212__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucaucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccaugcccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccaccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccguccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12035 - RNA, 9876 nt, Artificial Sequence
  derived and/or modified CDS sequence (opt2) from DENV-2__EU660400__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccaccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccgccagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12036 - RNA, 9876 nt, Artificial Sequence
  derived and/or modified CDS sequence (opt2) from DENV-2__EU569711__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacauccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12037 - RNA, 9876 nt, Artificial Sequence
  derived and/or modified CDS sequence (opt2) from DENV-2__EU569712__SS-prME
accgccggcaugaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaucacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccgcaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12038 - RNA, 9876 nt, Artificial Sequence
  derived and/or modified CDS sequence (opt2) from DENV-2__EU596487__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12039 - RNA, 9876 nt, Artificial Sequence
  derived and/or modified CDS sequence (opt2) from DENV-2__EU569713__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcuccgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggccaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaucacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuacaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggagaaggccggcguccucugguga

SEQ ID NO: 12040 - RNA, 9876 nt, Artificial Sequence
  derived and/or modified CDS sequence (opt2) from DENV-2__EU569714__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgucauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaucacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12041 - RNA, 9876 nt, Artificial Sequence
  derived and/or modified CDS sequence (opt2) from DENV-2__EU569715__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccacccccggcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12042 - RNA, 9876 nt, Artificial Sequence
  derived and/or modified CDS sequence (opt2) from DENV-2__EU569716__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaucugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaucacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcucccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12043 - RNA, 9876 nt, Artificial Sequence
  derived and/or modified CDS sequence (opt2) from DENV-2__EU569717__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucgucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12044 - RNA, 9876 nt, Artificial Sequence
  derived and/or modified CDS sequence (opt2) from DENV-2__EU569718__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggaguacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacgucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12045 - RNA, 9876 nt, Artificial Sequence
  derived and/or modified CDS sequence (opt2) from DENV-2__EU596488__SS-prME
accgccggcgucaucaucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaucaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12046 - RNA, 9876 nt, Artificial Sequence
  derived and/or modified CDS sequence (opt2) from DENV-2__EU596489__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaccauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgaguuccccuccaagcucgccuccgccaucaagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagaaggccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcaugcucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12047 - RNA, 9876 nt, Artificial Sequence
  derived and/or modified CDS sequence (opt2) from DENV-2__EU596490__SS-prME
accgccggcgucaucaucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacgucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12048 - RNA, 9876 nt, Artificial Sequence
  derived and/or modified CDS sequence (opt2) from DENV-2__EU596491__SS-prME
accgccggcgucaucaucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacgcccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccacccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccgucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggccgcgcccacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12049 - RNA, 9876 nt, Artificial Sequence
  derived and/or modified CDS sequence (opt2) from DENV-2__EU677141__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccggcaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaucacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12050 - RNA, 9876 nt, Artificial Sequence
  derived and/or modified CDS sequence (opt2) from DENV-2__EU677144__SS-prME
accgccggcaugaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggccucaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccauggagaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaucacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccgcaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12051 - RNA, 9876 nt, Artificial Sequence
  derived and/or modified CDS sequence (opt2) from DENV-2__EU677145__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucaucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccaugcccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccaccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccguccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12052 - RNA, 9876 nt, Artificial Sequence
  derived and/or modified CDS sequence (opt2) from DENV-2__EU677146__SS-prME
accgucggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggccaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12053 - RNA, 9876 nt, Artificial Sequence
  derived and/or modified CDS sequence (opt2) from DENV-2__EU687214__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccaacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaucgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12054 - RNA, 9876 nt, Artificial Sequence
  derived and/or modified CDS sequence (opt2) from DENV-2__EU687215__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaagaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccgccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12055 - RNA, 9876 nt, Artificial Sequence
  derived and/or modified CDS sequence (opt2) from DENV-2__EU687216__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucaacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgagcucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12056 - RNA, 9876 nt, Artificial Sequence
  derived and/or modified CDS sequence (opt2) from DENV-2__EU726770__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcaccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12057 - RNA, 9876 nt, Artificial Sequence
  derived and/or modified CDS sequence (opt2) from DENV-2__EU781135__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12058 - RNA, 9876 nt, Artificial Sequence
  derived and/or modified CDS sequence (opt2) from DENV-2__EU687222__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12059 - RNA, 9876 nt, Artificial Sequence
  derived and/or modified CDS sequence (opt2) from DENV-2__EU687223__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgccuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12060 - RNA, 9876 nt, Artificial Sequence
  derived and/or modified CDS sequence (opt2) from DENV-2__EU687227__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccagaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12061 - RNA, 9876 nt, Artificial Sequence
  derived and/or modified CDS sequence (opt2) from DENV-2__EU687228__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaacgagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12062 - RNA, 9876 nt, Artificial Sequence
  derived and/or modified CDS sequence (opt2) from DENV-2__EU687230__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcggcaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12063 - RNA, 9876 nt, Artificial Sequence
  derived and/or modified CDS sequence (opt2) from DENV-2__EU687231__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaacaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12064 - RNA, 9876 nt, Artificial Sequence
  derived and/or modified CDS sequence (opt2) from DENV-2__EU687199__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaugauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12065 - RNA, 9876 nt, Artificial Sequence
  derived and/or modified CDS sequence (opt2) from DENV-2__EU687235__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgacucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccucgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12066 - RNA, 9876 nt, Artificial Sequence
  derived and/or modified CDS sequence (opt2) from DENV-2__EU687236__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagaaggccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12067 - RNA, 9876 nt, Artificial Sequence
  derived and/or modified CDS sequence (opt2) from DENV-2__EU687237__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12068 - RNA, 9876 nt, Artificial Sequence
  derived and/or modified CDS sequence (opt2) from DENV-2__EU687238__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaccaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12069 - RNA, 9876 nt, Artificial Sequence
  derived and/or modified CDS sequence (opt2) from DENV-2__EU687240__SS-prME
accgucggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggccaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12070 - RNA, 9876 nt, Artificial Sequence
  derived and/or modified CDS sequence (opt2) from DENV-2__EU687241__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacuccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaccaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaccauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucgucaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12071 - RNA, 9876 nt, Artificial Sequence
  derived and/or modified CDS sequence (opt2) from DENV-2__EU687242__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugcuacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucaacgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12072 - RNA, 9876 nt, Artificial Sequence
  derived and/or modified CDS sequence (opt2) from DENV-2__EU687243__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucaacgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12073 - RNA, 9876 nt, Artificial Sequence
  derived and/or modified CDS sequence (opt2) from DENV-2__EU687245__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucaacgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacgcccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccucccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccgucaaccagguccgcucccucaucggcaacgaggaguacaccgacuacaugcccuccaugaagcgcuuccgcaaggaggaggaggaggccggcguccucugguga

SEQ ID NO: 12074 - RNA, 9873 nt, Artificial Sequence
  derived and/or modified CDS sequence (opt2) from DENV-2__HQ541798__SS-prME
accgccggcaugaucuucaugcucauccccaccgucauggccuuccaccucaccacccgcaacggcgagccccacaugaucgucucccgccaggagaagggcaagucccuccucuucaagaccggcgacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaguccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaaggacaugaagggcgaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagaugcucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagccccacacccucugguccaacgagguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaagauggagaaguaccagcucgccgucaccaucauggccauccucugcguccccaacgccgucauccuccagaacgccuggaaggucuccugcaccauccucgccgucgucuccgucuccccccucuuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucucccuccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgcaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccugguccuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucucccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccgccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12075 - RNA, 9876 nt, Artificial Sequence
  derived and/or modified CDS sequence (opt2) from DENV-2__JF730053__SS-prME
accgccggcaugaucaucaugcucauccccaccgucauggccuuccaccucaccacccgcaacggcgagccccacaugaucgucucccgccaggagaagggcaagucccuccucuucaagaccggcgacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaguccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacaugaagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagaugcucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacgagguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaagauggagaaguaccagcucgccgucaccaucauggccauccucugcguccccaacgccgucauccuccagaacgccuggaaggucuccugcaccauccucgccgucgucuccgucuccccccucuuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucucccuccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgcaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccugguccuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucucccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccgccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12076 - RNA, 9876 nt, Artificial Sequence
  derived and/or modified CDS sequence (opt2) from DENV-2__EU529706__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcgucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggccgcaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12077 - RNA, 9876 nt, Artificial Sequence
  derived and/or modified CDS sequence (opt2) from DENV-2__EU482720__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaccauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgccaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagaaggccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaccuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcaugcucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12078 - RNA, 9876 nt, Artificial Sequence
  derived and/or modified CDS sequence (opt2) from DENV-2__EU482721__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaccauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcaugcucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12079 - RNA, 9876 nt, Artificial Sequence
  derived and/or modified CDS sequence (opt2) from DENV-2__EU482722__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgucgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagacccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucauccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12080 - RNA, 9876 nt, Artificial Sequence
  derived and/or modified CDS sequence (opt2) from DENV-2__EU482723__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagcgcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12081 - RNA, 9876 nt, Artificial Sequence
  derived and/or modified CDS sequence (opt2) from DENV-2__EU482724__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccucccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12082 - RNA, 9876 nt, Artificial Sequence
  derived and/or modified CDS sequence (opt2) from DENV-2__EU482725__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacaccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggagguccgcaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccagcucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12083 - RNA, 9876 nt, Artificial Sequence
  derived and/or modified CDS sequence (opt2) from DENV-2__EU482726__SS-prME
accgccggcgucaucgucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaucggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacgcccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccacccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12084 - RNA, 9876 nt, Artificial Sequence
  derived and/or modified CDS sequence (opt2) from DENV-2__EU482727__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgccuacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgccgcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12085 - RNA, 9876 nt, Artificial Sequence
  derived and/or modified CDS sequence (opt2) from DENV-2__EU482728__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacucccucgucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12086 - RNA, 9876 nt, Artificial Sequence
  derived and/or modified CDS sequence (opt2) from DENV-2__EU482729__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgagaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaucgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucaucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgccuacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgccgcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12087 - RNA, 9876 nt, Artificial Sequence
  derived and/or modified CDS sequence (opt2) from DENV-2__EU482731__SS-prME
accgccggcgucaucgucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacgcccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccacccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggccgcgcccacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12088 - RNA, 9876 nt, Artificial Sequence
  derived and/or modified CDS sequence (opt2) from DENV-2__EU482732__SS-prME
accgucggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgccuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12089 - RNA, 9876 nt, Artificial Sequence
  derived and/or modified CDS sequence (opt2) from DENV-2__EU482733__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12090 - RNA, 9876 nt, Artificial Sequence
  derived and/or modified CDS sequence (opt2) from DENV-2__EU482734__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucaugaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccgucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugauggcccucaagaucgucaagaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccauccgcaacgaggaggaggagcagacccucaccauccucauccgcaccggccuccucgucaucuccggcgucuuccccgucuccauccccgucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucgucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccaucaccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12091 - RNA, 9876 nt, Artificial Sequence
  derived and/or modified CDS sequence (opt2) from DENV-2__EU482735__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucaugaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccgucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugauggcccucaagaucgucaagaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccauccgcaacgaggaggaggagcagacccucaccauccucauccgcaccggccuccucgucaucuccggcgucuuccccgucuccauccccgucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucgucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaccaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12092 - RNA, 9876 nt, Artificial Sequence
  derived and/or modified CDS sequence (opt2) from DENV-2__EU482736__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccaugcuccucgucgucgucuccuucgucacccucaucaccggcaacauguccuuccgcgaccucggccgcgucauggucauggucggcgccaccaugaccgacgacaucggcaugggcaucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucuccaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12093 - RNA, 9876 nt, Artificial Sequence
  derived and/or modified CDS sequence (opt2) from DENV-2__EU482737__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccaugcuccucgucgucgucuccuucgucacccucaucaccggcaacauguccuuccgcgaccucggccgcgucauggucauggucggcgccaccaugaccgacgacaucggcaugggcaucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucuccaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12094 - RNA, 9876 nt, Artificial Sequence
  derived and/or modified CDS sequence (opt2) from DENV-2__EU482739__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaaccucgagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12095 - RNA, 9876 nt, Artificial Sequence
  derived and/or modified CDS sequence (opt2) from DENV-2__EU482740__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcagcccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagcgcgucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12096 - RNA, 9876 nt, Artificial Sequence
  derived and/or modified CDS sequence (opt2) from DENV-2__EU482741__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccaugcuccucgucgucgucuccuucgucacccucaucaccggcaacauguccuuccgcgaccucggccgcgucauggucauggucggcgccaccaugaccgacgacaucggcaugggcaucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12097 - RNA, 9876 nt, Artificial Sequence
  derived and/or modified CDS sequence (opt2) from DENV-2__EU482742__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgcccccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12098 - RNA, 9876 nt, Artificial Sequence
  derived and/or modified CDS sequence (opt2) from DENV-2__EU482744__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucuccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12099 - RNA, 9876 nt, Artificial Sequence
  derived and/or modified CDS sequence (opt2) from DENV-2__EU482745__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccgcaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccaccaaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccaggucaagucccucaucggcaacgaggaguacaccgacuacaugcccuccaugaagcgcuuccgccgcgaggaggaggaggccggcguccucugguga

SEQ ID NO: 12100 - RNA, 9876 nt, Artificial Sequence
  derived and/or modified CDS sequence (opt2) from DENV-2__EU482746__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccgcaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12101 - RNA, 9876 nt, Artificial Sequence
  derived and/or modified CDS sequence (opt2) from DENV-2__EU482590__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccguccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccauccucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacaucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12102 - RNA, 9876 nt, Artificial Sequence
  derived and/or modified CDS sequence (opt2) from DENV-2__EU482594__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcaucaccuaccucgcccuccucgccgccuucaagguccgccccaccuucgccgccggccuccuccucaagaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgagggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12103 - RNA, 9876 nt, Artificial Sequence
  derived and/or modified CDS sequence (opt2) from DENV-2__EU482604__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcauccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12104 - RNA, 9876 nt, Artificial Sequence
  derived and/or modified CDS sequence (opt2) from DENV-2__EU482605__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucgucaccggccaccucaagugccgccuccgcauggacaagcuccagcucaagggcauguccuacuccaugugcaccggcaaguucaagaucgucaaggagaucgccgagacccagcacggcaccaucgucauccgcauccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggccaaccccgagaucgaggacgccaucuuccgcaagaagcgccucaccaucauggaccuccaccccggcgccggcaagcccaagcgcucccuccccgccaucguccgcgaggccaucaagcgcggccuccgcccccucauccucgcccccccccgcgucguccccgccgagauggaggagccccuccgcggccuccccauccgcuaccagacccccgccaucaagcccgaccacaccggccgcgagaucgucgcccucaugugccacgcccccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagcgccucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12105 - RNA, 9876 nt, Artificial Sequence
  derived and/or modified CDS sequence (opt2) from DENV-2__EU482606__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcauccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccaccccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12106 - RNA, 9876 nt, Artificial Sequence
  derived and/or modified CDS sequence (opt2) from DENV-2__EU482607__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcgucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaucgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccgucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccgacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucgcccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucacccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12107 - RNA, 9876 nt, Artificial Sequence
  derived and/or modified CDS sequence (opt2) from DENV-2__EU482608__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcauccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagcgccucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaucaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12108 - RNA, 9876 nt, Artificial Sequence
  derived and/or modified CDS sequence (opt2) from DENV-2__EU687220__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagaaggcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccaucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccucaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccacgccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12109 - RNA, 9876 nt, Artificial Sequence
  derived and/or modified CDS sequence (opt2) from DENV-2__EU726775__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuuccgcaccaacaccggcaccaucggcgccaucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuuccgcuccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12110 - RNA, 9876 nt, Artificial Sequence
  derived and/or modified CDS sequence (opt2) from DENV-2__FJ639732__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccgucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12111 - RNA, 9876 nt, Artificial Sequence
  derived and/or modified CDS sequence (opt2) from DENV-2__FJ639733__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgaggccaccaugcgcggcgccaagcgcauggccauccucggcgacaccgccugggacuucggcucccucggcggcgccuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaagauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12112 - RNA, 9876 nt, Artificial Sequence
  derived and/or modified CDS sequence (opt2) from DENV-2__FJ639734__SS-prME
accgccggcgucaucgucaugcucauccccaccgccaucgccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgaggucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcgcccucgucguccccugccgcaaccaggacgagcucaucggccgcgcccgcaccucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12113 - RNA, 9876 nt, Artificial Sequence
  derived and/or modified CDS sequence (opt2) from DENV-2__JN819408__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacaucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuuccgcaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaucacccaggaguccgagaacaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagggcgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12114 - RNA, 9876 nt, Artificial Sequence
  derived and/or modified CDS sequence (opt2) from DENV-2__FJ639783__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcgucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccgucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12115 - RNA, 9876 nt, Artificial Sequence
  derived and/or modified CDS sequence (opt2) from DENV-2__FJ639788__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccgccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcgucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccgucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacuacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12116 - RNA, 9876 nt, Artificial Sequence
  derived and/or modified CDS sequence (opt2) from DENV-2__FJ639822__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcgucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaucgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccgucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucgcccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucacccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12117 - RNA, 9876 nt, Artificial Sequence
  derived and/or modified CDS sequence (opt2) from DENV-2__FJ850112__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgccuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaagauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12118 - RNA, 9876 nt, Artificial Sequence
  derived and/or modified CDS sequence (opt2) from DENV-2__FJ850105__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcauccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgccgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12119 - RNA, 9876 nt, Artificial Sequence
  derived and/or modified CDS sequence (opt2) from DENV-2__FJ850106__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcauccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccacccuccucgucgccgccuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12120 - RNA, 9876 nt, Artificial Sequence
  derived and/or modified CDS sequence (opt2) from DENV-2__FJ850107__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcauccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuucccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggcaagcuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagauccgccaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12121 - RNA, 9876 nt, Artificial Sequence
  derived and/or modified CDS sequence (opt2) from DENV-2__FJ850108__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaucgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcaugauggucauggucggcgccaccaugaccgacgacaucggcaugggcgucaccuaccucgcccuccucgccgccuucaagguccgccccaccuucgucgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12122 - RNA, 9876 nt, Artificial Sequence
  derived and/or modified CDS sequence (opt2) from DENV-2__JN819407__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagaugucccucggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuucaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12123 - RNA, 9876 nt, Artificial Sequence
  derived and/or modified CDS sequence (opt2) from DENV-2__FJ898465__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagaaggcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccaugcuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaacuaccagcucgccgucaccaucauggccaucuccugcguccccaacgccgucauccuccucaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccacgccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12124 - RNA, 9876 nt, Artificial Sequence
  derived and/or modified CDS sequence (opt2) from DENV-2__FJ898466__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagcgcgcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacaucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuuccgcaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagcgcaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcucccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12125 - RNA, 9876 nt, Artificial Sequence
  derived and/or modified CDS sequence (opt2) from DENV-2__FJ898467__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcauccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12126 - RNA, 9876 nt, Artificial Sequence
  derived and/or modified CDS sequence (opt2) from DENV-2__GQ868595__SS-prME
accgccggcgucaucaucaugcucauccccaccgccauggccuuccaccucaccacccgcaacggcgagccccacaugaucgucucccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccucaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugcgcggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccaucaagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12127 - RNA, 9876 nt, Artificial Sequence
  derived and/or modified CDS sequence (opt2) from DENV-2__GQ868540__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucgucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccucaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12128 - RNA, 9876 nt, Artificial Sequence
  derived and/or modified CDS sequence (opt2) from DENV-2__GQ868541__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccucaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccacgccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcaccacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12129 - RNA, 9876 nt, Artificial Sequence
  derived and/or modified CDS sequence (opt2) from DENV-2__GQ868603__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuuccucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacguccucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgccgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgucgucaccaucauggccaucuccugcguccccaacgccgucauccuccagaacgccuggaaggucuccugcaccauccucgccgccgucuccgucuccccccuccuccucaccuccucccgccagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucuucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaucccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12130 - RNA, 9876 nt, Artificial Sequence
  derived and/or modified CDS sequence (opt2) from DENV-2__FJ898450__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgccuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuaccgcaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12131 - RNA, 9876 nt, Artificial Sequence
  derived and/or modified CDS sequence (opt2) from DENV-2__FJ898453__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagcgccaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgucuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucgcccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12132 - RNA, 9876 nt, Artificial Sequence
  derived and/or modified CDS sequence (opt2) from DENV-2__EU482445__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggacccucaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccaccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacaccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12133 - RNA, 9876 nt, Artificial Sequence
  derived and/or modified CDS sequence (opt2) from DENV-2__EU482446__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccaccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacaccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12134 - RNA, 9876 nt, Artificial Sequence
  derived and/or modified CDS sequence (opt2) from DENV-2__EU482448__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccaccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacaccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12135 - RNA, 9876 nt, Artificial Sequence
  derived and/or modified CDS sequence (opt2) from DENV-2__EU482449__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaacaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgccaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucaugacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccugguccuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcauguucugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucaucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagcgccucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12136 - RNA, 9876 nt, Artificial Sequence
  derived and/or modified CDS sequence (opt2) from DENV-2__EU482450__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccgccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccgucaagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacgccgacuacaugcccuccaugaagcgcuuccgccgcgaggaggaggaggccggcguccucugguga

SEQ ID NO: 12137 - RNA, 9876 nt, Artificial Sequence
  derived and/or modified CDS sequence (opt2) from DENV-2__EU569721__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccuccccccuccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12138 - RNA, 9876 nt, Artificial Sequence
  derived and/or modified CDS sequence (opt2) from DENV-2__EU482451__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccggcgccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccuccaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagaccaagaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaacgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggucgccaucaaccagguccgcucccucaucggcaacgaggaguacaccgacuacaugcccuccaugaagcgcuuccgccgcgaggaggaggaggccggcguccucugguga

SEQ ID NO: 12139 - RNA, 9876 nt, Artificial Sequence
  derived and/or modified CDS sequence (opt2) from DENV-2__EU660413__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggcuucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucauccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucucccccaccgccaucuuccucaccacccucucccgcuccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcggcaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagaagcccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12140 - RNA, 9876 nt, Artificial Sequence
  derived and/or modified CDS sequence (opt2) from DENV-2__EU660414__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcaaccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaucaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcucccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggucgccaucaaccagguccgcucccucaucggcaacgaggaguacaccgacuacaugcccuccaugaagcgcuuccgccgcgaggaggaggaggccggcguccucugguga

SEQ ID NO: 12141 - RNA, 9876 nt, Artificial Sequence
  derived and/or modified CDS sequence (opt2) from DENV-2__EU660415__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucggccccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccucggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaagggcaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgucaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12142 - RNA, 9876 nt, Artificial Sequence
  derived and/or modified CDS sequence (opt2) from DENV-2__EU687249__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacauccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccgcgaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucaugacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggccgcgucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcugguccgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12143 - RNA, 9876 nt, Artificial Sequence
  derived and/or modified CDS sequence (opt2) from DENV-2__EU660416__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagcgccgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaugaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucaugaccauccucugcguccccaacgccgucauccuccagaacgccuggaaggucuccugcaccauccucgccgucgucuccgucuccccccuccuccucaccuccucccgccagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaacaaggucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12144 - RNA, 9876 nt, Artificial Sequence
  derived and/or modified CDS sequence (opt2) from DENV-2__EU660417__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagcgccgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucaugaccauccucugcguccccaacgccgucauccuccagaacgccuggaaggucuccugcaccauccucgccgucgucuccgucuccccccuccuccucaccuccucccgccagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcucccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaacaaggucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12145 - RNA, 9876 nt, Artificial Sequence
  derived and/or modified CDS sequence (opt2) from DENV-2__EU677137__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaccgucaccgaggacugcggcucccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccgucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggccaugcagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12146 - RNA, 9876 nt, Artificial Sequence
  derived and/or modified CDS sequence (opt2) from DENV-2__EU677138__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggccgcgccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggucgccaucaaccagguccgcucccucaucggcaacgaggaguacaccgacuacaugcccuccaugaagcgcuuccgccgcgaggaggaggaggccggcguccucugguga

SEQ ID NO: 12147 - RNA, 9876 nt, Artificial Sequence
  derived and/or modified CDS sequence (opt2) from DENV-2__EU677149__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagcgccgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucaugaccauccucugcguccccaacgccgucauccuccagaacgccuggaaggucuccugcaccauccucgccgucgucuccgucuccccccuccuccucaccuccucccgccagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaacaaggucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12148 - RNA, 9876 nt, Artificial Sequence
  derived and/or modified CDS sequence (opt2) from DENV-2__FJ024452__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcggccaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccggcaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaucaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagguccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucgcccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12149 - RNA, 9876 nt, Artificial Sequence
  derived and/or modified CDS sequence (opt2) from DENV-2__FJ205877__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagcgccgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucaugaccauccucugcguccccaacgccgucauccuccagaacgccuggaaggucuccugcaccauccucgccgucgucuccgucuccccccuccuccucaccuccucccgccagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuaccccgaccgccgcuggugcuucgacggcaucaagaacaaccagauccucgaggagaacgucgaggucgagaucuggcccaaggagggcgagcgcaagaagcucaagccccgcuggcucgacccccgcaucuacuccgagccccgcgcccucaaggaguucaaggaguucccccccggccgcaagucccucacccucaaccucaucaccgagaugggccgccuccccaccuucaugacccagaagacccgcgacgcccucgacaaccucgccggccuccacaccgccgaggccggcggccgcgccgacaaccacgcccucuccgagcucgccgagacccucgagacccuccuccuccucacccuccucgccaccggcaccggcggcaucuuccucuuccucauguccggccgcggcaucggcaagaugacccucggcaugugcugcaucaucaccgccuccauccuccucugggacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucggcgccaccaugcccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcugggcccucgccaagauggacaucggcgucccccuccucggcaucggcugcuacucccaggucaaccccaucacccucaccggcgcccuccuccuccucggcggccacuacgccaucaucggccccggccuccaggccaaggccacccgcgaggcccagaagcgcgccgcccccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcgcccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggaccccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaaggccucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgccaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucccccgcauggccaucuccggcgacgacugcgucgucaagccccucgacgcccgcuucgccaacgcccucaccgcccucaacgccaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaacaaggucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12150 - RNA, 9876 nt, Artificial Sequence
  derived and/or modified CDS sequence (opt2) from DENV-2__FJ024454__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggccccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgagaacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggcccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaccggcgucguccgccuccucaccaagcccugggacguccuccccaccgucacccagauggccaugaccgacaccacccccuucggccagcagcgcgucuucaaggagaaggucgacacccgcacccaggaccccaaggaggccaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccuccccgucaccgaggaggucgccguccagaacuggcucgcccgcgucggccgcgagcgccucucccgcaugcccaucuccggcgacgacugcgucgucaagccccucgacgcccgcuuccccaccgcccucaccccccucaacgacaugggcaagauccgcaaggacauccaccagugggaccccuccaagggcuggaacgacuggacccagguccccuucugcucccaccacuuccacgagcucaucaugaaggacggccgcguccucgucguccccugccgcaaccaggacgaccucaucgcccgcgcccgcaucucccagggccccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggucgccaucaaccagguccgcucccucaucggcaacgaggaguacaccgacuacaugcccuccaugaagcgcuuccgccgcgaggaggaggaggccggcguccucugguga

SEQ ID NO: 12151 - RNA, 9876 nt, Artificial Sequence
  derived and/or modified CDS sequence (opt2) from DENV-2__FJ205878__SS-prME
uccgccggcaugaucaucaugcucauccccaccgucaccgccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuaccgcgagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaccgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccgucaagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12152 - RNA, 9876 nt, Artificial Sequence
  derived and/or modified CDS sequence (opt2) from DENV-2__FJ205879__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaccaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacccccgccgcggcaccggcaacaugggcgagacccucggcgagaaguggaagucccgccucaacgcccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12153 - RNA, 9876 nt, Artificial Sequence
  derived and/or modified CDS sequence (opt2) from DENV-2__FJ390385__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgccaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucggcugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcuccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaccgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12154 - RNA, 9876 nt, Artificial Sequence
  derived and/or modified CDS sequence (opt2) from DENV-2__FJ024458__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggccgccgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacauggacuacuggaucgaguccgcccucaacgacaccuggaagaucgagaaggccuccuucaucgaggucaagaacugccacugggccaagucccacacccucugguccaacggcguccucgaguccgagaugaucauccccaagaaccucgccggccccgucucccagcacaacuaccgccucggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12155 - RNA, 9876 nt, Artificial Sequence
  derived and/or modified CDS sequence (opt2) from DENV-2__FJ205880__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuccugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcucaagacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12156 - RNA, 9876 nt, Artificial Sequence
  derived and/or modified CDS sequence (opt2) from DENV-2__FJ390387__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagguccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccgucaagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucgucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12157 - RNA, 9876 nt, Artificial Sequence
  derived and/or modified CDS sequence (opt2) from DENV-2__FJ024461__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccucggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaagggcaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12158 - RNA, 9876 nt, Artificial Sequence
  derived and/or modified CDS sequence (opt2) from DENV-2__FJ373299__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacucccgccucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccggcggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggucgccaucaaccagguccgcucccucaucggcaacgaggaguacaccgacuacaugcccuccaugaagcgcuuccgccgcgaggaggaggaggccggcguccucugguga

SEQ ID NO: 12159 - RNA, 9876 nt, Artificial Sequence
  derived and/or modified CDS sequence (opt2) from DENV-2__FJ410193__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaccaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccgccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12160 - RNA, 9876 nt, Artificial Sequence
  derived and/or modified CDS sequence (opt2) from DENV-2__FJ410195__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucaucgucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucaugaccauccucugcguccccaacgccgucauccuccagaacgccuggaaggucuccugcaccauccucgccgucgucuccgucuccccccuccuccucaccuccucccgccagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccuccuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaagaacgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12161 - RNA, 9876 nt, Artificial Sequence
  derived and/or modified CDS sequence (opt2) from DENV-2__FJ432726__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgccucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcauccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12162 - RNA, 9876 nt, Artificial Sequence
  derived and/or modified CDS sequence (opt2) from DENV-2__JF730049__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgucgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaagaccuggggcaaggccaagauguucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcucaagacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccuccgcaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccuccaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaucgaggaguacaccgacuacaugcccuccaugaagcgcuuccgccgcgaggaggaggaggccggcguccucugguga

SEQ ID NO: 12163 - RNA, 9876 nt, Artificial Sequence
  derived and/or modified CDS sequence (opt2) from DENV-2__FJ562098__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgccaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaucgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcuccgccucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagauggucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12164 - RNA, 9876 nt, Artificial Sequence
  derived and/or modified CDS sequence (opt2) from DENV-2__FJ859028__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaagaacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggucgccaucaaccagguccgcucccucaucggcaacgaggaguacaccgacuacaugcccuccaugaagcgcuuccgccgcgaggaggaggaggccggcguccucugguga

SEQ ID NO: 12165 - RNA, 9876 nt, Artificial Sequence
  derived and/or modified CDS sequence (opt2) from DENV-2__FJ410200__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucaacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgagaacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccgccagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgccgcugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccgucaagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12166 - RNA, 9876 nt, Artificial Sequence
  derived and/or modified CDS sequence (opt2) from DENV-2__FJ410202__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccgucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgaggucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaucgacuacaugcccuccaugaagcgcuuccgccgcgaggaggaggaggccggcguccucugguga

SEQ ID NO: 12167 - RNA, 9876 nt, Artificial Sequence
  derived and/or modified CDS sequence (opt2) from DENV-2__FJ410208__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucaacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccgccagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugaucgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccgucaagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12168 - RNA, 9876 nt, Artificial Sequence
  derived and/or modified CDS sequence (opt2) from DENV-2__FJ461305__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcucaagacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagcgcgccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12169 - RNA, 9876 nt, Artificial Sequence
  derived and/or modified CDS sequence (opt2) from DENV-2__FJ410215__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccgccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12170 - RNA, 9876 nt, Artificial Sequence
  derived and/or modified CDS sequence (opt2) from DENV-2__FJ461309__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcucaagacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12171 - RNA, 9876 nt, Artificial Sequence
  derived and/or modified CDS sequence (opt2) from DENV-2__FJ461311__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucaacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccgccagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccagcucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccgucaagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12172 - RNA, 9876 nt, Artificial Sequence
  derived and/or modified CDS sequence (opt2) from DENV-2__FJ410217__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcaucgucuccuggaagaacaaggagcucaagugcggcuccggcaucuucgucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcuccgccucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcaucuucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucgccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacgcccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12173 - RNA, 9876 nt, Artificial Sequence
  derived and/or modified CDS sequence (opt2) from DENV-2__FJ410219__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccucauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcuuccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaugaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaucaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgucaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccgucaagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12174 - RNA, 9876 nt, Artificial Sequence
  derived and/or modified CDS sequence (opt2) from DENV-2__FJ461314__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggacccucaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacacccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12175 - RNA, 9876 nt, Artificial Sequence
  derived and/or modified CDS sequence (opt2) from DENV-2__FJ410221__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaucauggccgacgacaucggcaucggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccaguccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgucgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacgucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12176 - RNA, 9876 nt, Artificial Sequence
  derived and/or modified CDS sequence (opt2) from DENV-2__FJ547064__SS-prME
uccgccggcaugaucaucaugcucauccccaccgucauggccuuccaccucaccacccgcaacggcgagccccacauggucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuaccgcgagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgucgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacauccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaccgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccgucaagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12177 - RNA, 9876 nt, Artificial Sequence
  derived and/or modified CDS sequence (opt2) from DENV-2__FJ410223__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggcgcaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucgcccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucuccggcaaccucaagaacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgucgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12178 - RNA, 9876 nt, Artificial Sequence
  derived and/or modified CDS sequence (opt2) from DENV-2__FJ410224__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccgucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaccgucacccucuaccucggcgucaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12179 - RNA, 9876 nt, Artificial Sequence
  derived and/or modified CDS sequence (opt2) from DENV-2__FJ461321__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacuccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccaacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgaguccgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcauccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12180 - RNA, 9876 nt, Artificial Sequence
  derived and/or modified CDS sequence (opt2) from DENV-2__FJ410228__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaacggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcauccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12181 - RNA, 9876 nt, Artificial Sequence
  derived and/or modified CDS sequence (opt2) from DENV-2__FJ410233__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucaacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccgccagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccgucaagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12182 - RNA, 9876 nt, Artificial Sequence
  derived and/or modified CDS sequence (opt2) from DENV-2__FJ410237__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccgucaagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaucgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacgccgacuacaugcccuccaugaagcgcuuccgccgcgaggaggaggaggccggcguccucugguga

SEQ ID NO: 12183 - RNA, 9876 nt, Artificial Sequence
  derived and/or modified CDS sequence (opt2) from DENV-2__FJ410241__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcucaagacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccuccgcaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcucgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12184 - RNA, 9876 nt, Artificial Sequence
  derived and/or modified CDS sequence (opt2) from DENV-2__FJ410259__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaccaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgccgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcauccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12185 - RNA, 9876 nt, Artificial Sequence
  derived and/or modified CDS sequence (opt2) from DENV-2__FJ547067__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccaucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccaggucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggccgcaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12186 - RNA, 9876 nt, Artificial Sequence
  derived and/or modified CDS sequence (opt2) from DENV-2__JN819418__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucaugacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12187 - RNA, 9876 nt, Artificial Sequence
  derived and/or modified CDS sequence (opt2) from DENV-2__EU482640__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccaccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggcgccagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacucccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccguccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccgccagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcugguccaugcgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12188 - RNA, 9876 nt, Artificial Sequence
  derived and/or modified CDS sequence (opt2) from DENV-2__EU482641__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaucaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcauccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12189 - RNA, 9876 nt, Artificial Sequence
  derived and/or modified CDS sequence (opt2) from DENV-2__EU482642__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccgucuucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaucugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12190 - RNA, 9876 nt, Artificial Sequence
  derived and/or modified CDS sequence (opt2) from DENV-2__EU482643__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagaugaagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccaccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucaccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgacaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaugggcaacgaggaguacaccgacuacaugcccuccaugaagcgcuuccgccgcgaggaggaggaggccggcguccucugguga

SEQ ID NO: 12191 - RNA, 9876 nt, Artificial Sequence
  derived and/or modified CDS sequence (opt2) from DENV-2__EU482644__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaccggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucaugaccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12192 - RNA, 9876 nt, Artificial Sequence
  derived and/or modified CDS sequence (opt2) from DENV-2__EU482645__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagaagguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaccggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucaugaccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12193 - RNA, 9876 nt, Artificial Sequence
  derived and/or modified CDS sequence (opt2) from DENV-2__EU482646__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaccaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12194 - RNA, 9876 nt, Artificial Sequence
  derived and/or modified CDS sequence (opt2) from DENV-2__EU482647__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagaugaagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12195 - RNA, 9876 nt, Artificial Sequence
  derived and/or modified CDS sequence (opt2) from DENV-2__EU482648__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgccaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucaugacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucaucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagcgccucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12196 - RNA, 9876 nt, Artificial Sequence
  derived and/or modified CDS sequence (opt2) from DENV-2__EU482649__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccaucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucuccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucguccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagaaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12197 - RNA, 9876 nt, Artificial Sequence
  derived and/or modified CDS sequence (opt2) from DENV-2__EU482650__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggcaaguucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacacccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12198 - RNA, 9876 nt, Artificial Sequence
  derived and/or modified CDS sequence (opt2) from DENV-2__EU482651__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcuccgccucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucaccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucaccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucguccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12199 - RNA, 9876 nt, Artificial Sequence
  derived and/or modified CDS sequence (opt2) from DENV-2__EU482652__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacucccucugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccgccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccacccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccgucaagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacgccgacuacaugcccuccaugaagcgcuuccgccgcgaggaggaggaggccggcguccucugguga

SEQ ID NO: 12200 - RNA, 9876 nt, Artificial Sequence
  derived and/or modified CDS sequence (opt2) from DENV-2__EU482653__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcuccgccucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcaucuucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacgcccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12201 - RNA, 9876 nt, Artificial Sequence
  derived and/or modified CDS sequence (opt2) from DENV-2__EU482654__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagaugaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacacccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12202 - RNA, 9876 nt, Artificial Sequence
  derived and/or modified CDS sequence (opt2) from DENV-2__EU482656__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccauccucgacgaggagcgcgagauccccgagcgcuccuggaacuccggccacgagugggucaccgacuucgagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccgucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12203 - RNA, 9876 nt, Artificial Sequence
  derived and/or modified CDS sequence (opt2) from DENV-2__EU482657__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggaucaugcgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggauggaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccacccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgaggccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12204 - RNA, 9876 nt, Artificial Sequence
  derived and/or modified CDS sequence (opt2) from DENV-2__EU482658__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucaucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccaccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucaccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgacaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12205 - RNA, 9876 nt, Artificial Sequence
  derived and/or modified CDS sequence (opt2) from DENV-2__EU482659__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccaccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacaccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaagcacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcgacgaggaguacaccgacuacaugcccuccaugaagcgcuuccgccgcgaggaggaggaggccggcguccucugguga

SEQ ID NO: 12206 - RNA, 9876 nt, Artificial Sequence
  derived and/or modified CDS sequence (opt2) from DENV-2__EU482661__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgagggcgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12207 - RNA, 9876 nt, Artificial Sequence
  derived and/or modified CDS sequence (opt2) from DENV-2__EU482662__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagaaggcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgccaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucaugacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucaucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagcgccucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12208 - RNA, 9876 nt, Artificial Sequence
  derived and/or modified CDS sequence (opt2) from DENV-2__EU482663__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccuccgcaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaucgacuacaugcccuccaugaagcgcuuccgccgcgaggaggaggaggccggcguccucugguga

SEQ ID NO: 12209 - RNA, 9876 nt, Artificial Sequence
  derived and/or modified CDS sequence (opt2) from DENV-2__EU482664__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgccaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccgucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucaucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagcgccucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12210 - RNA, 9876 nt, Artificial Sequence
  derived and/or modified CDS sequence (opt2) from DENV-2__EU482665__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12211 - RNA, 9876 nt, Artificial Sequence
  derived and/or modified CDS sequence (opt2) from DENV-2__EU482666__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgccaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucaugacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucaugcgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucaucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagcgccucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12212 - RNA, 9876 nt, Artificial Sequence
  derived and/or modified CDS sequence (opt2) from DENV-2__EU482667__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggaggcccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucaucaagguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12213 - RNA, 9876 nt, Artificial Sequence
  derived and/or modified CDS sequence (opt2) from DENV-2__EU482668__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcauccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12214 - RNA, 9876 nt, Artificial Sequence
  derived and/or modified CDS sequence (opt2) from DENV-2__EU482669__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccgccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggucgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuacaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaccauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12215 - RNA, 9876 nt, Artificial Sequence
  derived and/or modified CDS sequence (opt2) from DENV-2__EU482670__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucaugaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccaggucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcauccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga
